United States Patent 10,407,724 (METHODS AND COMPOSITIONS FOR SCREENING AND TREATING DEVELOPMENTAL DISORDERS) - sequence listing, part 55

SEQ ID NO: 1447 - DNA, 1776226 bp, Homo sapiens
tcaagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatctgtaagcaaacagcctgacaagcaccctagtgtatttcaggatgactgacaggacacagtggcccaagcaagaaggggggatgggtgctcttaaagcaacatgccagtgaagggtaacatcaaacagcagaatcagacctgaaattctatttttcagatttacaatgaaataataatacattacccactatcaacttctaaatacaacttgcatggtcattatgtacccaaaacactgtaaatcccaaagtagaatttttgagaatttgtaaaagtagaaagaaaaaatataaaacaggcatgttatatgatacttccctgaagcgatcaagctttcaggttacttaagaatatgcctgttatttttaacagaaattaaatcaggctatccacagaaaagccattctttcttttccttataatatcaacttttattttagattcaggaagtacttgtacaggtttgttatatgggtatactacatgatgctgacatttagggtataattgatcccgttacccaggtagtgtccagtggtggggtgagaaaagcagttcttatctcaccttcatatatttgtcaatagctcttacaacagtaatttaggaataactaatgaaggtaatttaaatatcttgaattaatctgaattgttattgaggataggggccagagattcacgtattttccccctactgcattccttccctatgacctacttcatgattaaaatatagaccaaaagattcagaaattctacttatagatatttctacattaatttcactttagaaaacattttagtaacatattggcttcattcttcacatttacaattttttcctatattatttcacaatactctgcactgctcaatccttttataatagagcaatcatccatattttaaaaacaaacaaacaaaaaagccaagtcactcatttttaaacacaattcctcatttagccagcagagggtattattagattctgaaagcccacatattgcacccaatgacatgtatttttatacttcagctaggaactgggacacatcatctcaactttccttagtaaatgtgcttagaaatatcccattttattttgcccatataaatttgacttttagagcccagattaatgcttctcatctgtatcacactaccattatttcctcctctatctgctccaacagctgcatcctctgaaaaaaagcactagaagaccaagaagtggcagaattaccaagaagaagcagaattgggttcaatcatcagaaagacttcccacaatcctaaatttttctgggacaaacaaatgaacaacaatcttacataaagattctaagctccattagaaaatcgaaaacaaatcctgaagaaaacagaactaaattacaggataaaatctctcttcaaaattatatgacatttgtaacctctttaactccctgtttaatatttgctaaattttcattatatattagaagccacagactaattttaaagatatacttcctgttattacagcattaatatatttctcataaacatgcggtattatgactaacaaagttcccttacaatttataggttctttatttcacaacttaacactcacttagtgtggaaagacatggacagcaatttgcctgatttattctaaaaataaaaattttactatctaattagctaaaatcattaacttccacaaatttatcttggctgaagataaaaaattttctgtttctttgatgcaattatatcacaaacatcaagttaactaagttaactatggcaaaagtgaaaaagcaatttcaaagagcaatctctttttcctgctctcagatttgccactaatggcacatcctctatgctaaagtactaaattttccaaagagaaaataaatgttaattctcttcctcaattgtcattcaaaataaaaaattataggttattttcctttaaaggggaattctatttctaataataaaaacaagcattgggttcttcattgaaagaaactgctctataagatcgtctctcatactcaaatgtggcagtttctttcctcatgtaataactaacaatagccaggtaaatatcatattttacatttggaaataaaataggatacctcttaattatattcttttatgaaattttatatcttcaattttctaaacagatacattcgctgtaatataaaatagatacctgggcttttttctcaaattaacttataggataacccactattcagaataaaactgaaaagtcagttttgccagtaatttgcttatcctttttgccaatcatccacacattttggaatatgtatataaataattttgttattgttgttgtttctagttacccacttaattctactttacttttcagctctgagtttggtacctgacacaggctctcctgaactatgtctcactcaatggtttttggttttcgcaggtgccttaagaacctacatctaaaggccttattagcctcaattctatttgtagattaaaaaaaattaaggataacgcttaggggtagggagagattgaataagcagtgaatagatactacttacttaaaatactcctttttacttttagcaaaaatgcctccatacactatatgctgtatctgaattttcaatatattttatataggcaatagtccccccttatagacaaggtatgtgttccaagacccatagtgaattcctgaaaccacagatagttctgaaccctatatatgtttttcctatacctgcaaactatgataaagtttaatttataagttaggcaagaaattaacaataataattataaaatagagcaattataacaatatgcttgcatcagaactcttgcgctttggggctaggccacgacagtccatttgaaaatctagatggcctctaggagtgactaatgggcaggcagcatatacagcaggacatgctggacaaaaagatgattcgtgtcctgattgagacataacaggataacacaagatctcattgtgctactcagaatggcacacacttaaaacttgtggattggttatttctggaatttccatttcatattttcagaccagggttgaccttgagtatctaaaaccacagaaaatgcaaccacagataaggggcctactgtgtttcttttttttttttttttttttttttgagacggagtctcacactgtcacccgggctggagtgcaatggcgtgatctcggcttactgcaacctccgcctccccggttcaagtgaatctcctacctcagcctcccgagcagctgggattacaggcactcgccaccatgcccggctaattttttgtatttttagtagagatggggtttcactatgttggccaggctagtctcgaactcctgaccttgtgatctgcccgcctcggcctcccaaagggcctattgtatttcatttatcttcaaaacaacttattattcccctaaattacagcagtgggctcttagcaggtaatattcacaccaattgacaggtatagtgcaagctcggactctgacataggttaggtatgctaagtttgaggtgcagtggcatatgcaaatagttatgtcccatgagcaactggaaatgcagaatccatgaactttggagaaaaattatgcctagagatacagatatagtaacctgtccatccatgttacactctaatccataagagtagatgagctctcccaagattaactatagaaggaatgaggcagccacattacaaaacaagtacagtgaagaatatgatgagaagaaatgtcataataagaatagtaagaaatgcaaaacaaactgggttcaaattcaaactcactttaccctctttggcctcatccacaatgaccccaatttaccctgttttcctgatgtgaaatgagacctataaaacttctatgaagagtaattacttataaaattacacatagaatataatggaatgctaattaccatgccaaataattcatttatcaattattgttattttgtggaaagatacttttctctttgtgaaattctgcttttcaaaaccaaaatgccattgaattttagagggctgctgtgaaacacatcaaacagattgcccctttgatttttaaatggatagagaatgattatgtccacacagctttatttagcaaattgaatccatgccatcaatggaagtcttctactccatccacgttaataatttataattggatagcaagaaaacctggtactgaaatggaaatatgtttagagcttcttccaaagttgcaacatgcttaataaattaaagggacactaacacatattaataaactgagtattttttggaagagtgggtatagaatggttaaagatagaataccgaactaaacacaaacaaatgacactaagaaaaaatagaaacctctgtgtcttgttcccacataagacttgtggagttgtgccaacctgcttcattccagagcagagagccactcagtcactgaggctatattagaaagagaggaaggaaatccttttctcccacactctctgtttccaaagataataacagaaaactagagagtgatggatttcactactaagcagccatgtctattttactcatgtctttcattgactctctaagtctagttctactgattttgcataatagaacaaaagaaatatatgtacaaaaacaaaatcaattttgcaaaacttgtaatatccctaaattttccaaaatataactgctatagtcactaaattaaaactataacatcattcctattaggtcatcaattgtattcaaaagaatgaagcttatcacagagaaaggtaaaataattaaattcagtcatagagccaatgaatcacacttcttttacttcaaatgataaccctgccaaatcaaacagtctgagtaacccacacacacacatcccaagccaatccacttttatccccctgggtcttgggtgcacagaattagactgacacaatcaatcatggtcctaactggtggactagtctatgaaaagcctgttttattttttgttttcatagtctatattccctgttctcagttccattcccctctctgcttcttatggtagttaatgggtacatttccaattaaacttccgtaactttttttacatatgctatatacgtctacaagaatatataactttatgtgtatggatgtttaaatttacacaaataatattgtatttcccatctctttctacttctatctctctgtgtctgtttcattgtgtggttttgtttttttgtttgtttgtttgttttttggtctatctatgttggactataaagatgtggtaaacattgcatgtttgctcactcagcacatagtcccaaccttattctcccttatctttctctgctatggaggcaggacatttgatttcccagccttctttgcaactcagaatggcatgtgaaagaattctggccaatgagacggtaaagcttttgctttccctatcaaaaggacatcagcatccttgccatgtcttccttaacctgactgtggtaaggtgcctggaaataaaacaatcttactgcaaagctgaagaggaaggatgacagagcagaactatagaaagaacttgggcccttgatgacatccgttattaacttcttttttcttaattttattattattatactttaagttttagggtacatgtgcacaatgtgcaggtttgttacatgtctatacatgtgccatgttggtgtgctgcacccattaactcgtcatttagcattaggtatatctcctaatgctatccctccccgctccccccaccccacaacagtccctgaagtgtgatattccccttcctgtgtccaagtgttctcattgttcaattcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgttaatagtgccacaataaacatacgtgtgcatgtgtctttatagcagcatgatttataatcctttgggtatatacccagtaatgggatggctgggtcaaatggtatttgtagttctagacccctgaggaatcgccacactgacttccacaatggttgaactagtttacagtcccaccaacagtgtaaaattgttcctatttctccacatcctctccagcacctgttgtttcctgactttttgatgatcgccattctaactggtgtgagatggtatctcattgtggttttgatttgcatttctctgatggccagtgatgatgagcattttttcatgtgtctttggctgcataaatgtcttcttttgagaagtgtctgttcatatccttcgcccactttttggtggggttgtttgtttttttcttgtaaatttgtttgagttcattgtagattctgggtattagccctttgtcagatgagtaggttgcgaaaattttctcccattttgtgggttgcctgttcactctgatggtagtttcttctgctgtgcagaagctcttgagtttaattagatcccatttgtcaattttggcttttgttgccattgcttttggtgttttagacatgaagtccttgcccatgcctatgtcctgaatggtatcgcctaggttttcttctagggtttttatggttttaggtctaacatgtaagtctttaatccatcttgaattaatttttgtataaggtgtaaggaagggatccagtttcagctttctacgtagggctagccagttttcccagcaccatttattaaaaagggtatcctttccccattgcttgtttctctcaggtttgtcaaagatcagatggttgtagatatgaggcattatttctgagggctctgttctgttccattggtcgatatctctgttttggtaccagtatcatgctgttttggttactgtagccttgtagtatagtttgaagtcaggtagtgtgatgcctccagctttgttcttttggcttaggattgacttggcgatgcgggctcttttttggttccatatgaactttaaagtagtttttcccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcccaggtattttattctctttgaagcaattgtgaatggtagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtgtttgcccattcggtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccagggatgaagcccacttgatcaaactaaatctattatattagttaagaactcatttttatcacataacaagaagtctagaggtaagaagttaataacggacgtccgttattaacttcttacctctagacttcttgttatgtgataaaaatgagttcttaactaatataatagatttagtttgttcctttattttccattgtgtagcattctatcacatgcatttataaatatattttgtgtccatatcactaatcaagcacgtttcggtaatagccaactctttgctgtaggagacaatgctgtaataaacattctcatacatgtctctttgtgtgcctatgcaagagtccctctggtgtatacattctgttatgggctaaattgtatctcctcaaaattcctgtgttaaagtcctaaaccctagtacctcactcacgatatgactgtatttggagataggtccgttaaagaggtgattaggttaaaatgaggctgttaggatgggccctaattcagtcatactggtgtccttctaagaagaggaaattaggacatagagaagaaaagacatcaggaatgtgcacatagaggggcaaccatgtgagaaaggtggtcatctgcaagccaaggaaagaggcctcagaagaaaccaaacctgccaacaccttgatcttggacttatagcctccagaactgtgaaaaaataaatttctcttgcttaaagatcccagtctgtggtattttactctggcagtcctagcaaactaatacaattcagaagtagaatttctgggtcagaatgtgtgttcagtttcaataagtattgtcaaattggtctccaaaaaacaccaccagcagagaatgtaggttcacatgtccccacctcctcaccaaaacaagatattacatgacattttaactcccatcaacatgggacatgcaaaggagatatcacatcactattgttttgatttgcacttctgattaccagtgtaaatgctaatctctttttagttgattagtcagccattcaaatatcctttctatgaattgcttacttgtattcttcacctgtttttctcctaggttgcctgttcatttccttactgacttcaaagaattccctatatattgtaaatataatcttttgtcagtaatattccttgaaaatatcctctccctgcttcatatgtccctctttgtctaggataccttcccttgaacattgtaacatctgtatatgaaagttccattttcttcatatccttacacattctaggttattgccatacattaatatctaccaatttaatgagtagataaagtatcccattgttgttttaatgtgtctttacccagtaactagtgaagaaaactaagtttcttttgacttatttatgggtcattctagttttcttttctgtgaattaccttttcacatatcattgaccctattggattgttcgttttttgattatcttttccttattaattttttggagtttttaataaaatcttatgataaatgacttttgttaaatgatgtatgagtcaactattttgacaataacaccatataaaaaaaactaccactgaggtttagaactcagtggcctaagaaaacatttattatttcttgtggattttcaggttggctaaagattggctaattcagaatggacctggcttagcttgccccaggctatagttttgggatccagatctgctccacatttttctcatcctccttggacaagtaggccacttggagcatattcttctcatgaacagaaacacaagatgggcaaatggaaacattgagtacctcttaaggtgaaggctcaaagttggcactctgccttttctgcccacattctaatgggcaaagcaagttatatggccaagtctaacttttctgcccacattccgacaggcaaaacaagtcatatggccaagtctaacattaatggagcagggaaatacactctgcctctagcaggaggaattgcaaagacacatggcaaaggggatggatatagggagcaagaggattgggaaacaacaatgcaatccactttatatggatgaatgtaaacataccctgtcaactggtagtttttgtttctttttattgttttttcagtcttttaattaattaatttttgcattaatgtaataatttcagttttttactttatggctatgttttgggagtcttatttaagaaattatgtcctatcctaagatcataaatatattctatattttcctctagaatgcaatcatagggatcaataaccaatatattttaaattagcatatgcctaaatgtaagattatatcatataaactaaaggccgaggcacccaagttaagtaatcaaaattaaaaatatttacccaaggatggctacttatttcaggttaattttttagcttggtctttaaaatatattaatgatacaggctggcaaagaagagaaagacccaggaattataagaaatcacaaaacttgattgtcttttataaacagatctttattaatctaagcagtataggtatattcaaaaatgcaaagcacaagaacacagaaaaatatatacaatcttctgaggtcatgccactggaaaaggaaaaaagaaactttcacagaactgaacaattataaaatgatatatgttatgatgtcatatttgtaaaatatatgtgtatatgtggtaatagcagggtccacttcaatagttttgggtaaaaatgaggtcattactattaatttttcaagctaaaaccacttcccaattgccagactggcagggaatccagtatctctcttgtctctcaaattgttcaaaaactctgggggcatcttcattcacatgccacagagaaagaaaggcagagaagtggattagaatacaagtgggctttgttgaaggatgctggtgctctgttcctggtacacagtttactgatggaagctgactccccatagttcagtgagaccctttctcctgctgcactctagctgttgctgtggatccagtgagaggccacaatgatttaagacaagcataccattccggcaaatgtatggcacagaacccatgccttcaacgttttaatttaccaagcctagtggctgagtcaggagggccttccagtcagttacacatgtgccagaaacaaacacttctagggtaacataggccacaaggggggttctagtttaagggtctttggtgttctttctcactagcaaattttagtcagtactaatttgatgcaggggtcagaagaactcttcctaacaacagatacattgtaaaaggaaagagtccaggttttcagtcttctcctgtttgaaggctcccagattctacaaatttcctccagtctccccagtgttgaccagccctgcagctgaaacaagactagaaagggcaagctttctcaagttagaaaaagacccttttacgctagtatctgagacacaaaatgataaggatctcattaatgatttccaaacactggaggaaaattttcccttaccttaaggttcacagataaaatacaaaatgcccactttgactttcagataaacaaagaataattttttggcataagtatgccctatgcaatatttgggacatacttacacacgcacgcatgcacacacacatatgtgctgtttccttggaatttaaatcaagagtgtgtcctgtatttttatttactaaatctggccactttaccttatctacttcatgaattataaacaaggaaaaagggagctgaaactcacttgtgtctaaatttgcaacaacctcacatcccacccatgtatcctcacatcctatcaaagacttggggctggcacaaccaatcaaaaagtcagcttgcacccccttacttcaaagaagctgcttttcaggtagccaggggtgtttcctagacacctcctagcaatacatttctaactacactcagccagaagattttgagtcgcagaaatgcagcacaggatgagaggggacaaggaaagaatgacatattgtactctggtatgagaaagccccaaaagagaaggcagacataagaaaaacacagacagaagggtgctctggagattaggttttatgtgtctcttttagaaaggtgaatcgaattgcttcagattatctagggttaaattcacctccaagtagaggaacaaataataggagtaggagaagagttgccccgatgcaaatgtacctcctgtagcccagaaacttaacaagatacttgtccttcactttaagatttgagagaataattctgtagaatcaaaactaatactgattgagctcaaaggctacacatacctcatttctgacaaacaccaggactaaatataaatcttatgtatttcaaaaataacagaaaaaaacaaaatttaaaaatcgtgtaacataaaagaggaagacactttcttaaagatgtaagggaaaattatcaccaagacaaaagaaaatttagaatatatctcttctgtgttctcagtgaaatacccaaaaatgtaaattctaggaaagaagtgatggaaaggctaaaaagaaaagaaagttgactgaagtgacaggtcaagataaaaagagacctggcaaagatttaaacatccaagaatttggcaaaagaaaaagacaatgaagtaattaaaatctgaatcattcctctcctttatctcctgcctctctaccagcagcttcatcattcagagggcaaaagaagcaaagaatggaactgctaccctggatttaattattaccaacaaagaatgatacgttagggaagtgaaagtgacaggaaccttggggaaaattgaacatatcaccttagagttcattacagtaaagaaagaaaacacaaagcaaagtaagacaagtatcttagattgcttagcagttgagagaaaatataagaatgtcccagagccacagactttaaatgaaaaataggtcaaaaaacttaagccattactacatcacacagatggtatacaaggagccttctaaagagctgagatgtttaaagaacacacaaaagaaggaagaaggtaaaggttaggatgaacacatcactgtagtatcagtctattagaaaagtagtgtaaacctaggatgagcaaagacttaaacaacacaaaaacttttaaggttgtgtttgatgatggaagtagataaaaaaggtacaagtctcctcctcccccagacagatttcatattaacaagtaatagagagaaagcaaaataacaatatttttactttgctttcatcttgtctcccaaggagaatggtctttaaaataaaaagattgtaccaacaatcttgagatgaaattgataaacgagaaaggagaaaagatagtaagagaatgcttaacaatttagataaatgaccatttctgggtatattccattaaagcagggtttctcatcttcagtgctattgacatttgaggctggataactctttatggttgggggctttcctgtgtgttgtaaaatgtttagcagcatccctggcttctacccactagatgccaaaagaacctgccccctagttatgacagccaaaaatgtctccagacattgccaaatgtcctctgagaagcaaaagcaccctgagttgagaaccactattttacagagcactgaaaaacatgcacatattatcacagaattcttgctggcatttggcatactaatggaaaatgagagtggtaacagaatattgggaattcacaaatgttttcccatatatcagaaaggtagaatttaaaaagtaaaaccaaattctatcttggtctctagaaaagtatcaaaatattattaattagaaaagagaacaatgattttttgctacattggtataggttcattaggagccactcatagtaaactaacttaattttcttctcttcctttttttaaaaaaatcattgctaaaagataaaattggtttcactcaaacattttttaaatcttttgtgaaattttctttgccaagataaagaaatgtgagctatctcatacactgttggtcaaagtgaatattggtaaaatctctttgaaaagcattctggcagtatccacaaaattttatatgcacgaattattgaacaaagtaatgccacttctagggatctgaacatacgaacaaagatgtatatcacaaactgcagaattgtttgtagcaacaaaaggtagaaacaacctaaatgtgcattaataagggactggttaaataaattgtcatatattctttcattggtctgacttttaattattattagtgggtcagaaaagccttaaaaaatatatagaatctaattggatgtcaattgagtaacagtaggagagatattaaaaatatttaacaaccagcatggctcaggccccaagcaatcagagcttaggctggagctgtcttggaagcttcatcctgtgccaagtgtttacctttcagttgctgggtctaggaaaggtccagggggtctcaagcagaggccaagtgaaggaaaatcactggtaagggtaagggagaagtacaaaagcatttcatattttaacaatttgtatgcctcactagggactatcagtcctcactaacagataaaacattaaaataactcagaataacatggagcaataaattgactgaaatagaacccagatttcaccaatcaatcatggcttgggtgagattttagaacgtcacaggaatcagatccttctaggaaagctgcgatggggcttccagtgtccagcccaaaagcaccaaacggtagaaaccagtacttctgtatcactgtccaatcttcccagctgcattgtctttgtttctctggctctcatggagaatctatgaactacctaatgtcatttatgaaactcttgttgcttaaaccagctaaagtagactttagttataatcaaaaaccctggctaaggtaccctttactaaaataaatatgcatatataactttttactttaagaaagttaatttttataaatgactttttaaaaaagatatgtggactgattagttacagatctgaggaaacacctggttgaagaaataaatccaaaagagcagtatagagatctagatcccaaaagcccatatgaatattagctgtgtatcaaccaccggaggcacttcttaaaaatacaaatgtggacccaaatcaatggctcactttcttacacataataactaattttaaaatatgatggaaggaaagagaccgtttatgataccaataaaaattttttaaatactgatatgaaaacaactttaaaactctactgagggttgtaaaagaagaattaagtatattaaaaagtgatgtataggcaaattgaacattacagaagtgttaattctccctgttaaatgtccacagaccacttgagaacttgataaaatgttaaaattcatctagaaataaatattatgtgattacatctaggaaaatcctgaaaggacagaaaagaatatggagaaggattattccttccagttattaaaacatattatgaaatgaagttattttaaaagtagggattggaaaaaataggaacaaatattaatagaacaggaaagacagctgagaaatggactccaatataaacttagcttatgataaatacggcttttcaaattatcaggaaaaaaggtgattcttaaataaattataatgatcaactgaataaacatttaggagaaaaattaaaaataaagcttactccctgctcactcttttgcccaaattcaattccagatgtagcaagaattttaaagttctgaaagtatgaatatataagtttatgtataataaatgtataataactaagtggaaatttttatgtataatacatttttaaagtatgtataataaatttataataattaagcagaaagccctttctaagcaaaactcaaaacccagaagctataaaggaagaggtttaaaattttgactacaaaaatattttgttttctatataattcaaaaataaaacaaaagtcataaaataaacaacaaattatggggaaatacctggaacatattaaacaggcaaaaagctaatttgcttaatttactatggtgggataaaaagaagaactcagccaggcgtggtggctcatgcctgtaatcccagcactttgggaggttgagggagatggatcacaaggtcacaagatcaagaccatgctggctaacacagtaaaaccccatctctactaaaaacacaaaaaaattagccaggcgtggtggtgggcacccgtaatcgcagctactcgggaggctgaggcaggagaattgcttgaacccaggaggcagaggttgcagtgagccgagattgcgccattgcactccaacctgggtgacaagagcaaaaccccgtctcaaaaaaaaaaaaaaaaaatttagcccagcgtggtggtgggcgcctatagtcccagctacttgggaggctgaggcaggagaatggtgtgaacacacgaggcggagcttgcagtgagctgagatggcaccactgcactctagcctgggtgacagagcgagactctatctcaaaaaaaaaaaaagactcaatagaaaaaattgggcaagtatttgtaaaggcaatttatgtaaaaagaagggcaatgggttaataagtacttagaaattgttcaactatacttataattaattaaatgcaaatcaaataaaacaagatattattttcaccaagcagccaaaattgaaaatttttgatatggtatcatcagtgctgtttaagtgttaggaacataagctcttagtatacactgttgaaggggtataaactgatatgaacttcttgaagagaaatatgacaatacatctcaaattataaattatgtgtactcttgaatatttccaattaaatgtaatacttatgaaattttaaaataaacattcccattgatacagcaattccacttccatgaacgtattctaaggatacactcaaaaagtacaccaggatatatgaacaagcatattcattgcacacagcaacaggacaaacaaacaacaaatactgaaaactacaaacatgtccatcaattcagaatgggctaaataaattctgctacatacacagagtaaaacacgacaaagctgctggaaagaatgaggcaggtctattagaactgctatgcatctgtcttaaccaaatataactgtcttaagcgggaagaagatacaagatcaacctgcataacattatgccttttttttcttgacccaaattagggttctgtcaattagcaagcagaggagaatacatggatattgcataggcaaccaacagtgtctatcacagactatttgattcttaagattcctttgtaatcccacattgggaaaatagaaattgcagagtctaacagaaaagcaagttaatcctgcaaattcccatgaaaacatgacccatgagcttcagccctggactaagaacccaggatctcttctggtgaatctcagagaagttggtttatgtattactctgtcttcacccccatccacaaaaacacacacattagaaaggaaacatcatgaggacagggtctatttttggttcactggtatttatctccagactaagaactatgtctggcacacaagtcatatagaatgaatgaatgaattccaaaccaacattagagtagacccagtgtagcccttcagcaatcctgcctctcagttattctgtgggctcctcaatgagctaactctgggcctctttgaactgatgccacccctagaggcctcatcaactgagaattggtaattcatttattacccagttaattgtataccttcatcccaattctctgccttcatgcatataggtaagagtgtgtccagaattggttccttctggtgggttcttgatctcactgacttcaagaacgaagccacagacactcgtggtgagtgttaccactcttaaagatgttgtgtccagagtttgttcctttagatgtgtccagagtttcttccttccggtgggttcacggtcttgctgacttcaggagtgaagccacagaccttctcagtgagtgttacagctcttaaaggcggcatatccggagtggtttgttcctcccgatgggttcacggtctcgctcacgtcaggaatgaagccgcagaccctcgtggtgagtattacagctcataaaggtaatgcgaacccaaagagtgagcaacagcaaaatttattgtgaagagcaaaagaacaaagcttccacagcatggaaggggacctgagcgggttgccgctgctggctcaggtggccagcttttattcccttatttggccccacccacatcctgctgattggtccattttacagagcgctgattggtccgttttacagagtgctgattggtccgtttttacagagtgctgattggcacgtttacaaacctttagctagacacagagcactgactggtgcgtttttacagactgctgattggtgcatttacaaacctttagctagacacagagtgctgattggtgcatttttgcagagtgctgattggtgcatttacacatctttagccagacacagagcactgatttgtgcgtttttacagagtgctgactggtgcgtttacaaacctttagctagacacagagtgctgactgatgcgtttacaacctttagctagacagaaaattctccaagtccccacccaacccagaagcccagccggcttcatctctcaatcccccctctaaacaggacaccccaactgcttttgggaattgggcgatgaccgctctagctacttcctgctggataggggcaaagaaggggcctgccctgcagttctagtttcctccagaggggatctctttaggccagtgaaagggccagcgggtcactccaggggtcctcagtagaagttgttagttgagctcatttggggttccatttgtaagaccatctgtaacttgatggccttgattctagaggaaacaaatttgacgaagaggttaaaaatacagggcccgaaggtgagtaatagcaagattgctgtcatgggacctagaaaagggagaagccatgttgcccaactccagaggttggtataagagtttgaaaggtgttgtctgatttcagaagccttttcctgtaaacgctgggcggcatcttgtactatccctgactggttagtgtaaaagcaacactcttccgctaagaaggtgcaaagtcctcctttctcagcagtgaggaggtctaagcctcggcagttttggagagtcactgctgccgaagagtctatttgggattgtagagtaaggatagattttgttatttcttgcaaactgtctgagaaatcctttgagagtgtgtggtagtaggataatacatgttactccgttaacttttagcaaactttacttttgttgaaaaccttgtaagtttgggattttaattattctttgctattaataaaccctcgttcagtccatattaacttagaattggtatagatggctccttcctgattctgtaagtactttaaggtttagctgagtgcaaacagcttgcacatttaagcagaccaattattaggcaattttcctaactctgcttctacaagagtttccttatcacttactgaacacccattgtctttttcccttaatcgcccaggaggaaccatctatcgtcctgtcctgaagggagttcctcctaggtctggttggacctttgtatggtaattaattatgatttagatcccctgttaggaaacttgctgtgttaaggattttagataggaaggctatgggttgtcagtggcctcagtgctttcgggctacacccttgtttacactgacaacaaggtggtatttgagtgttatagggttacagagaagaccttcaattatcaattataggtttttaatttaccctggcttttaaaggaatagggtacactgttttttctttactacttctatctctctctttctccctctttgatttcttcatctgtctgtctctttctctctgactccctctttgtctcttcctctttccttgtttgactttctgtctctctgtatcttcctctctctgtctctctctttgactccttctttgtctctgtctcttcctctgtctccttctctttgtctatctgtttcttcctctctctctttccttctgtctttgactttgtctctctctttctttctctccatcttttctctctggtggttttggcagtcttatactccttgggtttttgcattgtatgcaataactccagggtttccttgtgatatttaatgggggttcccccagaggttaggaactccctttctttccatattgcagcatgggcatgtaggattagataagcatacttgctatctgtatacacatttattcttcttccctttcccagttctaaggcttgggtaagtgccactagttctgctaactgggtgctggtccctgggggaagaggcttagtttcaagtactgttactatggcataacctgcccttcgtatcccattctccacaaatgaactttcatcggtatataggttaaggtcaggattagctaaggggacttctaagagatcatcttgggtggcataagtctggactataacctgttggtagccatgcttgaccagctcctcatcctctggtagaaaagtggcagggctgagggccacacatgtatgcacttgaagcactggtccctcaaggagtagcgcctggtatctaagcaggcggttgtctgataaccataaacttcctttggcacctagtatgccatttacattgtgagtagtccagacagtgagatcctttccttgtattattttgatagcctctgacactaagacagccaccgccacaactacctgtaaacagtgaggccagacttttgctactatatcaatttccttacttaggtatgtcactgattgtggggttgtcccatgagtctgagtaaggaccccaagagctattcctgctctctttgtgatgtataaagaaaagttttgtcctgtgggaaggcttaaggatggaccttgagtttgttccttccaatgcccagacttcagggttgattccctcctcaagcaggggacaacaaatgggtaacttgttccccatattcatagataatagctccagctttggctaatatgtccctccctaataagggtgtgggactttcagacacaacaagaaaggcatgtgaaaagagcaaagtctcccagttacaactgaggaggtgggagaaatacctggttacaggccatcccaggattcctcagatggtaacggaccttgaggacagctgtccaggacaggagattaacactgagaaggccatgccagtgtccaggaggaaatcaatttcctggccctcaatggttaaacatacccggggctcagtgagggtgatgacatgagctggcacttgccccgggcatcctcagtcctgttgttggatcatctggttgggggcttctggcccagagaaccattgtactctggggcagtgagccttccagtgattgcctccgcatagtggacatgggtgagggagcagcttatttctagtaggacaatcttttttaaagtgtccttgcaaaccatactgaatacaagccctaccaggtgattgacctgctctattttctgtcctctctgaaccaccaaggtttgtttgtctgagggccatgactaaggctgtggcctttctctgatcttgcttttctttttgggcctgtttctcttggtccctattatagaacaccgaggttgccaggtttaataatgcctccagattttgttcagggcgcaaggctcgcttttggagctttctcctgatatctgtggctgattaggtaataaacttatcttttagaatcaattgaccctcgagtgggtcgggtgacaggagagtatattttcttaaggcctcccatagctgttcgaggaaggcagaaggattttcttcctttccctgagttacggtggacatcattgaataattcacaggctttttcctaattctccttagtccttctaaaacacaggtcaacagatgtttgcaactccagtccccatgatctgagtcgaggtcccagtggggatccatactggggatggcttgctgaccagtagggaatttgcccctttcttcgactgtcattctatcatttacttgactaagataccaggtatctccaaactctcgggctgcaactaaagccacattcttttcattaaaggccagagtttgacctaatagcatgatatctctccaagtgaggtcaaaggtttgccctagaccctgtaagacatctatatacctaacaggatcatctgaaaacttccccagatctgccttgatctgctttaaatcagagagggagaaggggacatgtacccgggttgggccaaattcccctccccctacagcttgaaggggacataaatgatagctcaggggtttttgtggtcctttggagatttctttgtttgtttccttctgggtgggggagattagaggaggcttatcattaataggaaggggagctatagggaggctaggatatggaggtaagctgagaggtcctcctgtgggatgtaaattgcaagttttgcatagttgtgtattctccttcaatgaaaagaaagcttggacataaggtatttcactccatttgccttccttcttacagaaaaagtcaagctgcaggataggattgtactttatacttccttcaggtggccatctttcccatcagagagagaatattggggccaggccatagtgcagaaaaaagttagctgcctctttttcagggtttgcaggtcaaattggtcccaatggcttaggatgcatttcaagggtgagcctgttgatgcctgagtgtttcccatctgaaagacaaaaccacccttggtcttggtttgtttctacccctccccaagaacccacaatagtccctggaccctgctgattggaatagttgcacttactgatgcagcaacagaaacacctcttgcccaagaacccgcaacggtccctggaccctgctgatcagaatagttgtgctcaccgacgcagcatcagaaacactagttttcctcttagaccaaaaagaggaccgaggaaggtcagatttagtggcccttactgatgcattctcaaaaacctgcattcttgcctgtcctcttagaccacaaagaggaccaagaaaaattggatttagtggcccttaccgatgcattctcaaaaagctgttagagtcctaagcattatcctgttagtattgggaccttaccactgtcctataaagatgttatgccccaaaaatgaactggacggacataccctgagagagggaaaggatctccagagttggaagagtgatgctttttgtcctcacttatatgaataggaaagataccatttccgaagctccccatatcctagcttcaggaatagcttttgttaggcctgcttgtctgaagagggatcctaaaattccagatagtcccttgcccagatgggactttgggcaaaaattatgtctttctgattggtgagcccgggtgcctaaagaaggtaaaagagtcctgaagtttatactagaaatcattcttataggagaaactagaaaagcaccagagacagggagtgctttttagaagtggactagcctcagagaagagaggcgagaggaagtttgtctgacaggcattaggacccaggaggcaagggtcaggagataggatagatgggcaagtctcgcttgggtgacatgattttgagagttccactcatggccgcagggtcaaccaacttgttgttgggaccccggagctgaatggctttcctctctgtcaaccctcggctcagcctggaagtaccattaaagtggaagctggctccaggcaaaccaacattcccaactccatagagtcagggattgttagagagccctatcccagaaagcctggcacctgtgtctttagtccagcggccgcgctagttgcttttagctgaccgacaggtgcccagtatttacccccagaattctaaggaaaaacaggacagaatagcaagcaaaaggggtctgatggtactcatcacttggcaataggcgagagtcccatctgggttgccaaaatgtgtccagaattggttgcttctggtgggttcttggtctcgctgacttcaagaatgaagccgcagaccccacggtgactgttaccactcttaaagatggtgtgtctggagtttattccttcagatgttcatatgtgtccggagttactcccttccggtgggttcgtggtcttgctgacttcaggagtgaagccacagaccttcacagtgagtgttacggctcttaaaggcagcacgtctggagttgtttgttcctcccagtgggttcatgatctggctgacttcaggaatgaagccacagaccctcacggtgagtgttacagctcataaaggtagtgcggacccaaagagtgagcagcagcaagatttattatgaagagtgaaagaacaaagcttccacagtgtggaaggggacccgagcaggttgccactgctggctcaggtagccagcttttattctcttatttggcccccaccatgtcctgctgattggtccattttacagagtgctgattggtccattttacagagtgactggttctgtttttacagagtcctgattggtgcatttacaaacctttagctagacacagagcgctgattggtgcatttttgcagagtgctgattggtgcgtttacaaacctttagctagactagacacagagcactgattggtgcatttacaatcccttagctattcagaaaagttctccaagtccccacctgaccctgaagcctagccagcttcacctctcaagaggagataaatgtttatacagtgtaacttaagcaacgctactcaaactgcaggtctgcgatgagaaaaggagcttgtaccagaatgtaagttaatgagtgcttccttcatctagaaagtcttgctacagcctctccctctccctctccgtctctgtctccctctccccacggtctccctctccctctctttccacggtctccctctgatgccgagccgaagctggacggtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgtcggccgggctggtctccagctcccaaccacgagtgatccaccagcctcggcctcccaaggtgctgggattgcagatggagtctcgttcactcagtgctcaatggtgcccaggctggagtgcagtggcatgatctcggctcactacaacctccacctcccagcagcctgccttggcctcccaaagtgccgagattgcagcctctgcctggccaccaccccgtctgggaagtgaggagcatctccgcctggccgcccatcatctgggatgtgaggagcccctctgcctggctgcccagtctggaaagtgaggagcgtctctgcctggccgccatcccatctaggaagtgaggagcgcctcttcccggccaccatcacatctgggaagtgaggagcgtctctgcccggccgcccatcgtctgagatgtggggagcacctctgccctgccgccccgtccgggatgtgaggagcgtctctgcccggtcgccccgtctgagaagtgaggagaccctctgcctggcaaccgccccgtctgagaagtgaggagcccctccgcccggcagccgccccatctgagaagtgaggagcccctccacccagcagccaccccgtctgggaagtgaggagtgtctccgcccggcagccacctcgtccgggagggaggtgggggggtcagccccccgcctggccagccgccccgtccaggaggtgaggggcgcctctgcccggccgcccctactgggaagtgaggagcccctctgcctggccagctgccccgtccgggagggaggtgggggggtcagccccccgcccggccagccaccccgtccgggagggagggaggtaggggggtcagccccccacccggccagccgccccatccgggaagtgaggggcgcctctgcccggccgcccctactgggaagtgaggagcccctctgcccggccagccgccccgtccgggagggaggtgggggggtcagccccccgcccggccagctgccccctccgggagggaggtggggggtcagccccctgcccggccagccgccccctctgggaggtgaggggtgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtgggggaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaaaaaaagtcttgctacaaagtgcttagggtgtagctgatttactttcaggcacaagcctcttatctcgtttcatagattagttaaaaattgggaacttctaattacattttgaacagtgctaatttaaagtaggggcctccattgttcaagttccagtatttgagagactttctttgcactaaacattgccttctccttcaaatcaatttccccattgccaggaggcatctgaagcagaaaatcatcctggttaggataatgaaaggcaaagaaaagaggtggggagggtgccaaataaacttgacctaatcttccattttgcacacaggaactcaaagtcacctatcatatgctagaagctagtgattaaattggttacagattactcgctgaatcccaggcaaaaataatgtggttaaaaacagtatttaagcatgtgaaaaatcagatgtatcggctaacagtcctgttcaccttcaaaaattctgcagcctcaattatctgtcactttccattagatttgcaactttgctaaactccggagttccaccccgctgtaccatctcacttaaaatccagtatccaaacaagaatcagaaaatcacactttttaaatctctagactagcattcccatgagccaatgatccataaataaacactattttcaagttttcattacaaagcgcataatttctcttcaggccagtttgggttgccaacttctcttcttaaatcttaatcccttctattccaaaaaaaatagaaacatgcaaacagaagttcatggggaatagagaatgaaactcccatccttctgtagctatggtttttctctaaatattattactgaataataaaaacttcacaatttaaaaagttttttaatacaggaagaatatattatttgataattcataactctacctctcacttcacaccacataatattgatatctctaatctctccactttgattacttgggaccagtaaccacttccaataattagttgtatttatcactaattccttagctttcttccttctactctatttacacaacatggttctcaaactcaacaatgacagaattaaaacttatcttctctgactcctaccatagccacgcctaattccattctcatgttttccctatagaaaaacccaatactgaattgctcctctagcatgtgccctctatcccttttctttctagtctgttgcctacagattttctccaaatacttctaatttctccaaagattcacaataagtaaagaatttattcttcctattcctatttctttgtcacagttgtatcataaaagtcatataaatcactatgtctacatggtcttctaataaagttacttatacattctgttattttcatgtgcaaagtaacgtaagtgatcaacaatactatctatcggtttcaggcagagctgaagtattttcaactctgacatgtagctttgttgatatctgtaaaagtttattgagtggaaattttgtaggtaggagagattccatccttctaaacactaagtattttggtatctatgtgcctgataacaatgttttgcacatcatagacaataaatatatcatttggtagactaggaattttacaatgctttaaaagaataacagtaaaaacacatcttaaatatcacaacttttaccttcaaacatagtgttctctaatccaacacttctacagttagaaacagagattaaggaaattatcttaaacatatctacaacatacatatacacataagtaaataaatacacaaagatgtttaccatagcatctagatgttcagcaatgattaataaaattatattcattcacttgaacaaatgttacacaaatttaaaataacaccactgtagaataggtaatattctgtggaaaatgttttggtatatggttaaatgaaaaagcaaggttccaaattttatctatactattattgcaattatttttaaagccatctagaaaaaaaaagactagaaggaaacacatcaatgaaattacaggaaatatttttctgtgctttcaaaattcctacgatgaacatttaatgcttttataatgaaaaaaagttttaccaatctttactcaaataggaagatttagactatgtgtaggaggtaacaaatgggaataactttgtctatactgtctgtattttaggtttctccatttaacaaacttgtcctatggttctactgagataattttttataatggacaatgaaattttaatagcacactcaaatatgccattcaaatctgaccatggataatctgaatcttcaaatcacaactattctcaatatgttgagctttcaatctgtctaaaaagctagccacaaacccagaaccaatgcaaacttgaaatcctgctttttccactttgttttaagcaaatcattgcattctcacgttatctccagagatcttagtaggcacatatcagtgactcaaaacctctacagtaaatgaactttctgatgtctaaccccaatttcttcttgtttccatttgaactcatttcttttatttgtcttccgtgtaactgacagcagctgctcacaatcattcagatcccattagatagtgaccttttctttacatgattgatcattacatctcatgatcattccatacagtgattttcatttgactataactggtcatcaaacagttctgagagcattcctcaacctcttaatattccttccaattataaaacaaatagacattaaattcagaaattaatgctttttgccattatctcacttgaaacatcttccatttactatgaattagcttttggttgaaagtaaaatcccttcaaacatattccatctttgcttccttttccccactcccatgccaaagcacaagcatccaggccatatcttatcttttcctgcacagtatccaatcggctttttatagccagaaactctctgaatgcaaagcacgaccttggctaccagcttcccctggcaatagttcgaaagttatttataactttaaaattagcgtgaaagcctacgtttctcataactagtcaaaacattcctatttcatacaataatgtgatcttcctcagttcagaagaaaaccccaaattttaaacctatgattataactaagacacaggaattcaatgcagaaatgagaattcgctgaagttcagctcttctctttacaaacttgattcttacctttctgtttcttcctataaagtaaatgggcttaaaattcagctcccgtagggaattttccaaaaagagctttgtgggggacggaaaaaggcttcttggtggtcacagagttacagagtaccaaattgagaggcagatgacagtggggcagtcaatttcgctgagcgttgttcacccaggataagaaagaaa
